United States Patent 12,570,711 (PLATFORMS FOR CO-STIMULATION, NOVEL CAR DESIGNS AND OTHER ENHANCEMENTS FOR ADOPTIVE CELLULAR THERAPY) - sequence listing, part 6

SEQ ID NO: 8845 - DNA, 2565 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8846 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8847 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8848 - DNA, 2520 bp, Artificial Sequence
  Synthetic Polynucleotide encoding a CAR with optional accessory module(s)
atggccttaccagtgaccgccttgctcctgccgctggccttgctgctccacgccgccaggccgcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctggcggaggcggaagtggaggcggaggatctggcggcggaggctcttgatacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 8849 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccgcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctggcggaggcggaagtggaggcggaggatctggcggcggaggctcttgatacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8850 - DNA, 2598 bp, Artificial Sequence
  Synthetic Polynucleotide encoding a CAR with optional accessory module(s)
atggccttaccagtgaccgccttgctcctgccgctggccttgctgctccacgccgccaggccgcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctggcggaggcggaagtggaggcggaggatctggcggcggaggctcttgatacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8851 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccgcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctggcggaggcggaagtggaggcggaggatctggcggcggaggctcttgatacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8852 - DNA, 1839 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8853 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8854 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8855 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8856 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8857 - DNA, 1932 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8858 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8859 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8860 - DNA, 3363 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 8861 - DNA, 3213 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8862 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8863 - DNA, 2652 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8864 - DNA, 3684 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 8865 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8866 - DNA, 4179 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 8867 - DNA, 3177 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8868 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8869 - DNA, 1929 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8870 - DNA, 1839 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8871 - DNA, 2085 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8872 - DNA, 2133 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8873 - DNA, 1950 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 8874 - DNA, 1485 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8875 - DNA, 1488 bp, Artificial Sequence
  Synthetic Polynucleotide encoding a CAR with optional accessory module(s)
atggccttaccagtgaccgccttgctcctgccgctggccttgctgctccacgccgccaggccgcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaggcggaggcggaagtggaggcggaggatctggcggcggaggctcttgatacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8876 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 8877 - DNA, 2706 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8878 - DNA, 2670 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8879 - DNA, 2565 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8880 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8881 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8882 - DNA, 2520 bp, Artificial Sequence
  Synthetic Polynucleotide encoding a CAR with optional accessory module(s)
atggccttaccagtgaccgccttgctcctgccgctggccttgctgctccacgccgccaggccgcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaggcggaggcggaagtggaggcggaggatctggcggcggaggctcttgatacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 8883 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccgcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaggcggaggcggaagtggaggcggaggatctggcggcggaggctcttgatacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8884 - DNA, 2598 bp, Artificial Sequence
  Synthetic Polynucleotide encoding a CAR with optional accessory module(s)
atggccttaccagtgaccgccttgctcctgccgctggccttgctgctccacgccgccaggccgcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaggcggaggcggaagtggaggcggaggatctggcggcggaggctcttgatacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8885 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccgcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaggcggaggcggaagtggaggcggaggatctggcggcggaggctcttgatacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8886 - DNA, 1839 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8887 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8888 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8889 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8890 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8891 - DNA, 1932 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8892 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8893 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8894 - DNA, 3363 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 8895 - DNA, 3213 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8896 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8897 - DNA, 2652 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8898 - DNA, 3684 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 8899 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8900 - DNA, 4179 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 8901 - DNA, 3177 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8902 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8903 - DNA, 1929 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8904 - DNA, 1839 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8905 - DNA, 2085 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8906 - DNA, 2133 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8907 - DNA, 1950 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 8908 - DNA, 1539 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8909 - DNA, 1542 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaggcggaggcggaagtggaggcggaggatctggcggcggaggctcttgagaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8910 - DNA, 2067 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 8911 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8912 - DNA, 2724 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8913 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8914 - DNA, 2649 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8915 - DNA, 2598 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8916 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaggcggaggcggaagtggaggcggaggatctggcggcggaggctcttgagaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 8917 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaggcggaggcggaagtggaggcggaggatctggcggcggaggctcttgagaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8918 - DNA, 2652 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaggcggaggcggaagtggaggcggaggatctggcggcggaggctcttgagaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8919 - DNA, 2601 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaggcggaggcggaagtggaggcggaggatctggcggcggaggctcttgagaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8920 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8921 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8922 - DNA, 1938 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8923 - DNA, 1935 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8924 - DNA, 1923 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8925 - DNA, 1986 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8926 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8927 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8928 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 8929 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8930 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8931 - DNA, 2706 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8932 - DNA, 3738 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 8933 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8934 - DNA, 4233 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 8935 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8936 - DNA, 2043 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8937 - DNA, 1983 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8938 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8939 - DNA, 2139 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8940 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8941 - DNA, 2004 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 8942 - DNA, 1485 bp, Artificial Sequence; identical to SEQ ID NO: 8840
  Synthetic Polynucleotide encoding a CAR with optional accessory module(s)

SEQ ID NO: 8943 - DNA, 1488 bp, Artificial Sequence; identical to SEQ ID NO: 8841
  Synthetic Polynucleotide encoding a CAR with optional accessory module(s)

SEQ ID NO: 8944 - DNA, 2013 bp, Artificial Sequence; identical to SEQ ID NO: 8842
  Synthetic Polynucleotide encoding a CAR with optional accessory module(s)

SEQ ID NO: 8945 - DNA, 2706 bp, Artificial Sequence; identical to SEQ ID NO: 8843
  Synthetic Polynucleotide encoding a CAR with optional accessory module(s)

SEQ ID NO: 8946 - DNA, 2670 bp, Artificial Sequence; identical to SEQ ID NO: 8844
  Synthetic Polynucleotide encoding a CAR with optional accessory module(s)

SEQ ID NO: 8947 - DNA, 2565 bp, Artificial Sequence; identical to SEQ ID NO: 8845
  Synthetic Polynucleotide encoding a CAR with optional accessory module(s)

SEQ ID NO: 8948 - DNA, 2595 bp, Artificial Sequence; identical to SEQ ID NO: 8846
  Synthetic Polynucleotide encoding a CAR with optional accessory module(s)

SEQ ID NO: 8949 - DNA, 2544 bp, Artificial Sequence; identical to SEQ ID NO: 8847
  Synthetic Polynucleotide encoding a CAR with optional accessory module(s)

SEQ ID NO: 8950 - DNA, 2520 bp, Artificial Sequence; identical to SEQ ID NO: 8848
  Synthetic Polynucleotide encoding a CAR with optional accessory module(s)

SEQ ID NO: 8951 - DNA, 2568 bp, Artificial Sequence; identical to SEQ ID NO: 8849
  Synthetic Polynucleotide encoding a CAR with optional accessory module(s)

SEQ ID NO: 8952 - DNA, 2598 bp, Artificial Sequence; identical to SEQ ID NO: 8850
  Synthetic Polynucleotide encoding a CAR with optional accessory module(s)

SEQ ID NO: 8953 - DNA, 2547 bp, Artificial Sequence; identical to SEQ ID NO: 8851
  Synthetic Polynucleotide encoding a CAR with optional accessory module(s)

SEQ ID NO: 8954 - DNA, 1839 bp, Artificial Sequence; identical to SEQ ID NO: 8852
  Synthetic Polynucleotide encoding a CAR with optional accessory module(s)

SEQ ID NO: 8955 - DNA, 1854 bp, Artificial Sequence; identical to SEQ ID NO: 8853
  Synthetic Polynucleotide encoding a CAR with optional accessory module(s)

SEQ ID NO: 8956 - DNA, 1884 bp, Artificial Sequence; identical to SEQ ID NO: 8854
  Synthetic Polynucleotide encoding a CAR with optional accessory module(s)

SEQ ID NO: 8957 - DNA, 1881 bp, Artificial Sequence; identical to SEQ ID NO: 8855
  Synthetic Polynucleotide encoding a CAR with optional accessory module(s)

SEQ ID NO: 8958 - DNA, 1869 bp, Artificial Sequence; identical to SEQ ID NO: 8856
  Synthetic Polynucleotide encoding a CAR with optional accessory module(s)

SEQ ID NO: 8959 - DNA, 1932 bp, Artificial Sequence; identical to SEQ ID NO: 8857
  Synthetic Polynucleotide encoding a CAR with optional accessory module(s)

SEQ ID NO: 8960 - DNA, 3201 bp, Artificial Sequence; identical to SEQ ID NO: 8858
  Synthetic Polynucleotide encoding a CAR with optional accessory module(s)

SEQ ID NO: 8961 - DNA, 3204 bp, Artificial Sequence; identical to SEQ ID NO: 8859
  Synthetic Polynucleotide encoding a CAR with optional accessory module(s)

SEQ ID NO: 8962 - DNA, 3363 bp, Artificial Sequence; identical to SEQ ID NO: 8860
  Synthetic Polynucleotide encoding a CAR with optional accessory module(s)

SEQ ID NO: 8963 - DNA, 3213 bp, Artificial Sequence; identical to SEQ ID NO: 8861
  Synthetic Polynucleotide encoding a CAR with optional accessory module(s)

SEQ ID NO: 8964 - DNA, 3201 bp, Artificial Sequence; identical to SEQ ID NO: 8862
  Synthetic Polynucleotide encoding a CAR with optional accessory module(s)

SEQ ID NO: 8965 - DNA, 2652 bp, Artificial Sequence; identical to SEQ ID NO: 8863
  Synthetic Polynucleotide encoding a CAR with optional accessory module(s)

SEQ ID NO: 8966 - DNA, 3684 bp, Artificial Sequence; identical to SEQ ID NO: 8864
  Synthetic Polynucleotide encoding a CAR with optional accessory module(s)

SEQ ID NO: 8967 - DNA, 3204 bp, Artificial Sequence; identical to SEQ ID NO: 8865
  Synthetic Polynucleotide encoding a CAR with optional accessory module(s)

SEQ ID NO: 8968 - DNA, 4179 bp, Artificial Sequence; identical to SEQ ID NO: 8866
  Synthetic Polynucleotide encoding a CAR with optional accessory module(s)

SEQ ID NO: 8969 - DNA, 3177 bp, Artificial Sequence; identical to SEQ ID NO: 8867
  Synthetic Polynucleotide encoding a CAR with optional accessory module(s)

SEQ ID NO: 8970 - DNA, 1989 bp, Artificial Sequence; identical to SEQ ID NO: 8868
  Synthetic Polynucleotide encoding a CAR with optional accessory module(s)

SEQ ID NO: 8971 - DNA, 1929 bp, Artificial Sequence; identical to SEQ ID NO: 8869
  Synthetic Polynucleotide encoding a CAR with optional accessory module(s)

SEQ ID NO: 8972 - DNA, 1839 bp, Artificial Sequence; identical to SEQ ID NO: 8870
  Synthetic Polynucleotide encoding a CAR with optional accessory module(s)

SEQ ID NO: 8973 - DNA, 2085 bp, Artificial Sequence; identical to SEQ ID NO: 8871
  Synthetic Polynucleotide encoding a CAR with optional accessory module(s)

SEQ ID NO: 8974 - DNA, 2133 bp, Artificial Sequence; identical to SEQ ID NO: 8872
  Synthetic Polynucleotide encoding a CAR with optional accessory module(s)

SEQ ID NO: 8975 - DNA, 1950 bp, Artificial Sequence; identical to SEQ ID NO: 8873
  Synthetic Polynucleotide encoding a CAR with optional accessory module(s)

SEQ ID NO: 8976 - DNA, 1500 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8977 - DNA, 1503 bp, Artificial Sequence
  Synthetic Polynucleotide encoding a CAR with optional accessory module(s)
atggccttaccagtgaccgccttgctcctgccgctggccttgctgctccacgccgccaggccgcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaggcggaggcggaagtggaggcggaggatctggcggcggaggctcttgagaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8978 - DNA, 2028 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 8979 - DNA, 2721 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8980 - DNA, 2685 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8981 - DNA, 2580 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8982 - DNA, 2610 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8983 - DNA, 2559 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8984 - DNA, 2535 bp, Artificial Sequence
  Synthetic Polynucleotide encoding a CAR with optional accessory module(s)
atggccttaccagtgaccgccttgctcctgccgctggccttgctgctccacgccgccaggccgcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaggcggaggcggaagtggaggcggaggatctggcggcggaggctcttgagaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 8985 - DNA, 2583 bp, Artificial Sequence
  Synthetic Polynucleotide encoding a CAR with optional accessory module(s)
atggccttaccagtgaccgccttgctcctgccgctggccttgctgctccacgccgccaggccgcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaggcggaggcggaagtggaggcggaggatctggcggcggaggctcttgagaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8986 - DNA, 2613 bp, Artificial Sequence
  Synthetic Polynucleotide encoding a CAR with optional accessory module(s)
atggccttaccagtgaccgccttgctcctgccgctggccttgctgctccacgccgccaggccgcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaggcggaggcggaagtggaggcggaggatctggcggcggaggctcttgagaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8987 - DNA, 2562 bp, Artificial Sequence
  Synthetic Polynucleotide encoding a CAR with optional accessory module(s)
atggccttaccagtgaccgccttgctcctgccgctggccttgctgctccacgccgccaggccgcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaggcggaggcggaagtggaggcggaggatctggcggcggaggctcttgagaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8988 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8989 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8990 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8991 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8992 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8993 - DNA, 1947 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8994 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8995 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8996 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 8997 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8998 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8999 - DNA, 2667 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9000 - DNA, 3699 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9001 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9002 - DNA, 4194 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9003 - DNA, 3192 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9004 - DNA, 2004 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9005 - DNA, 1944 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9006 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9007 - DNA, 2100 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9008 - DNA, 2148 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9009 - DNA, 1965 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9010 - DNA, 1485 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9011 - DNA, 1488 bp, Artificial Sequence
  Synthetic Polynucleotide encoding a CAR with optional accessory module(s)
atggccttaccagtgaccgccttgctcctgccgctggccttgctgctccacgccgccaggccgcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaggcggaggcggaagtggaggcggaggatctggcggcggaggctcttgatacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9012 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9013 - DNA, 2706 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9014 - DNA, 2670 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9015 - DNA, 2565 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9016 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9017 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9018 - DNA, 2520 bp, Artificial Sequence
  Synthetic Polynucleotide encoding a CAR with optional accessory module(s)
atggccttaccagtgaccgccttgctcctgccgctggccttgctgctccacgccgccaggccgcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaggcggaggcggaagtggaggcggaggatctggcggcggaggctcttgatacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9019 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccgcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaggcggaggcggaagtggaggcggaggatctggcggcggaggctcttgatacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9020 - DNA, 2598 bp, Artificial Sequence
  Synthetic Polynucleotide encoding a CAR with optional accessory module(s)
atggccttaccagtgaccgccttgctcctgccgctggccttgctgctccacgccgccaggccgcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaggcggaggcggaagtggaggcggaggatctggcggcggaggctcttgatacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9021 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccgcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaggcggaggcggaagtggaggcggaggatctggcggcggaggctcttgatacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9022 - DNA, 1839 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9023 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9024 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9025 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9026 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9027 - DNA, 1932 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9028 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9029 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9030 - DNA, 3363 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9031 - DNA, 3213 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9032 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9033 - DNA, 2652 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9034 - DNA, 3684 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9035 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9036 - DNA, 4179 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9037 - DNA, 3177 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9038 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9039 - DNA, 1929 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9040 - DNA, 1839 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9041 - DNA, 2085 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9042 - DNA, 2133 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9043 - DNA, 1950 bp, Artificial Sequence
  Synthetic Polynucleotide encoding a CAR with optional accessory module(s)
atggccttaccagtgaccgccttgctcctgccgctggccttgctgctccacgccgccaggccgtacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9044 - DNA, 1524 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9045 - DNA, 1527 bp, Artificial Sequence
  Synthetic Polynucleotide encoding a CAR with optional accessory module(s)
atggccttaccagtgaccgccttgctcctgccgctggccttgctgctccacgccgccaggccggatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaggcggaggcggaagtggaggcggaggatctggcggcggaggctcttgaagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9046 - DNA, 2052 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9047 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9048 - DNA, 2709 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9049 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9050 - DNA, 2634 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9051 - DNA, 2583 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9052 - DNA, 2559 bp, Artificial Sequence
  Synthetic Polynucleotide encoding a CAR with optional accessory module(s)
atggccttaccagtgaccgccttgctcctgccgctggccttgctgctccacgccgccaggccggatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaggcggaggcggaagtggaggcggaggatctggcggcggaggctcttgaagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9053 - DNA, 2607 bp, Artificial Sequence
  Synthetic Polynucleotide encoding a CAR with optional accessory module(s)
atggccttaccagtgaccgccttgctcctgccgctggccttgctgctccacgccgccaggccggatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaggcggaggcggaagtggaggcggaggatctggcggcggaggctcttgaagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9054 - DNA, 2637 bp, Artificial Sequence
  Synthetic Polynucleotide encoding a CAR with optional accessory module(s)
atggccttaccagtgaccgccttgctcctgccgctggccttgctgctccacgccgccaggccggatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaggcggaggcggaagtggaggcggaggatctggcggcggaggctcttgaagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9055 - DNA, 2586 bp, Artificial Sequence
  Synthetic Polynucleotide encoding a CAR with optional accessory module(s)
atggccttaccagtgaccgccttgctcctgccgctggccttgctgctccacgccgccaggccggatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaggcggaggcggaagtggaggcggaggatctggcggcggaggctcttgaagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9056 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9057 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9058 - DNA, 1923 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9059 - DNA, 1920 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9060 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9061 - DNA, 1971 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9062 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9063 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9064 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9065 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9066 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9067 - DNA, 2691 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9068 - DNA, 3723 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9069 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9070 - DNA, 4218 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9071 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9072 - DNA, 2028 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9073 - DNA, 1968 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9074 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9075 - DNA, 2124 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9076 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9077 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9078 - DNA, 1545 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9079 - DNA, 1548 bp, Artificial Sequence
  Synthetic Polynucleotide encoding a CAR with optional accessory module(s)
atggccttaccagtgaccgccttgctcctgccgctggccttgctgctccacgccgccaggccgctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaggcggaggcggaagtggaggcggaggatctggcggcggaggctcttgagaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9080 - DNA, 2073 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9081 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9082 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9083 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9084 - DNA, 2655 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9085 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9086 - DNA, 2580 bp, Artificial Sequence
  Synthetic Polynucleotide encoding a CAR with optional accessory module(s)
atggccttaccagtgaccgccttgctcctgccgctggccttgctgctccacgccgccaggccgctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaggcggaggcggaagtggaggcggaggatctggcggcggaggctcttgagaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9087 - DNA, 2628 bp, Artificial Sequence
  Synthetic Polynucleotide encoding a CAR with optional accessory module(s)
atggccttaccagtgaccgccttgctcctgccgctggccttgctgctccacgccgccaggccgctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaggcggaggcggaagtggaggcggaggatctggcggcggaggctcttgagaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9088 - DNA, 2658 bp, Artificial Sequence
  Synthetic Polynucleotide encoding a CAR with optional accessory module(s)
atggccttaccagtgaccgccttgctcctgccgctggccttgctgctccacgccgccaggccgctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaggcggaggcggaagtggaggcggaggatctggcggcggaggctcttgagaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9089 - DNA, 2607 bp, Artificial Sequence
  Synthetic Polynucleotide encoding a CAR with optional accessory module(s)
atggccttaccagtgaccgccttgctcctgccgctggccttgctgctccacgccgccaggccgctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaggcggaggcggaagtggaggcggaggatctggcggcggaggctcttgagaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9090 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9091 - DNA, 1914 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9092 - DNA, 1944 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9093 - DNA, 1941 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9094 - DNA, 1929 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9095 - DNA, 1992 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9096 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9097 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9098 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9099 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9100 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9101 - DNA, 2712 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9102 - DNA, 3744 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9103 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9104 - DNA, 4239 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9105 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9106 - DNA, 2049 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9107 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9108 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9109 - DNA, 2145 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9110 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9111 - DNA, 2010 bp, Artificial Sequence
  Synthetic Polynucleotide encoding a CAR with optional accessory module(s)
atggccttaccagtgaccgccttgctcctgccgctggccttgctgctccacgccgccaggccggaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaactggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9112 - DNA, 1524 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9113 - DNA, 1527 bp, Artificial Sequence
  Synthetic Polynucleotide encoding a CAR with optional accessory module(s)
atggccttaccagtgaccgccttgctcctgccgctggccttgctgctccacgccgccaggccggatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaggcggaggcggaagtggaggcggaggatctggcggcggaggctcttgaagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9114 - DNA, 2052 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9115 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9116 - DNA, 2709 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9117 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9118 - DNA, 2634 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9119 - DNA, 2583 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9120 - DNA, 2559 bp, Artificial Sequence
  Synthetic Polynucleotide encoding a CAR with optional accessory module(s)
atggccttaccagtgaccgccttgctcctgccgctggccttgctgctccacgccgccaggccggatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaggcggaggcggaagtggaggcggaggatctggcggcggaggctcttgaagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9121 - DNA, 2607 bp, Artificial Sequence
  Synthetic Polynucleotide encoding a CAR with optional accessory module(s)
atggccttaccagtgaccgccttgctcctgccgctggccttgctgctccacgccgccaggccggatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaggcggaggcggaagtggaggcggaggatctggcggcggaggctcttgaagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9122 - DNA, 2637 bp, Artificial Sequence
  Synthetic Polynucleotide encoding a CAR with optional accessory module(s)
atggccttaccagtgaccgccttgctcctgccgctggccttgctgctccacgccgccaggccggatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaggcggaggcggaagtggaggcggaggatctggcggcggaggctcttgaagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9123 - DNA, 2586 bp, Artificial Sequence
  Synthetic Polynucleotide encoding a CAR with optional accessory module(s)
atggccttaccagtgaccgccttgctcctgccgctggccttgctgctccacgccgccaggccggatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaggcggaggcggaagtggaggcggaggatctggcggcggaggctcttgaagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9124 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9125 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9126 - DNA, 1923 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9127 - DNA, 1920 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9128 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9129 - DNA, 1971 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9130 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9131 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9132 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9133 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9134 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9135 - DNA, 2691 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9136 - DNA, 3723 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9137 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9138 - DNA, 4218 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9139 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9140 - DNA, 2028 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9141 - DNA, 1968 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9142 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9143 - DNA, 2124 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9144 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9145 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccgagttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9146 - DNA, 1539 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9147 - DNA, 1542 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaggcggaggcggaagtggaggcggaggatctggcggcggaggctcttgagaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9148 - DNA, 2067 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9149 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9150 - DNA, 2724 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9151 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9152 - DNA, 2649 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9153 - DNA, 2598 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9154 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaggcggaggcggaagtggaggcggaggatctggcggcggaggctcttgagaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9155 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaggcggaggcggaagtggaggcggaggatctggcggcggaggctcttgagaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9156 - DNA, 2652 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaggcggaggcggaagtggaggcggaggatctggcggcggaggctcttgagaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9157 - DNA, 2601 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaggcggaggcggaagtggaggcggaggatctggcggcggaggctcttgagaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9158 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9159 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9160 - DNA, 1938 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9161 - DNA, 1935 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9162 - DNA, 1923 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9163 - DNA, 1986 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9164 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9165 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9166 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9167 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9168 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9169 - DNA, 2706 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9170 - DNA, 3738 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9171 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9172 - DNA, 4233 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9173 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9174 - DNA, 2043 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9175 - DNA, 1983 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9176 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9177 - DNA, 2139 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9178 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9179 - DNA, 2004 bp, Artificial Sequence
  Synthetic Polynucleotide encoding a CAR with optional accessory module(s)
atggccttaccagtgaccgccttgctcctgccgctggccttgctgctccacgccgccaggccggaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9180 - DNA, 1542 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9181 - DNA, 1545 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaggcggaggcggaagtggaggcggaggatctggcggcggaggctcttgagaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9182 - DNA, 2070 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9183 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9184 - DNA, 2727 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9185 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9186 - DNA, 2652 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9187 - DNA, 2601 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9188 - DNA, 2577 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaggcggaggcggaagtggaggcggaggatctggcggcggaggctcttgagaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9189 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaggcggaggcggaagtggaggcggaggatctggcggcggaggctcttgagaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9190 - DNA, 2655 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaggcggaggcggaagtggaggcggaggatctggcggcggaggctcttgagaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9191 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaggcggaggcggaagtggaggcggaggatctggcggcggaggctcttgagaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9192 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9193 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9194 - DNA, 1941 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9195 - DNA, 1938 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9196 - DNA, 1926 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9197 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9198 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9199 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9200 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9201 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9202 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9203 - DNA, 2709 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9204 - DNA, 3741 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9205 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9206 - DNA, 4236 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9207 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9208 - DNA, 2046 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9209 - DNA, 1986 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9210 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9211 - DNA, 2142 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9212 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9213 - DNA, 2007 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgcttaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9214 - DNA, 1542 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9215 - DNA, 1545 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaggcggaggcggaagtggaggcggaggatctggcggcggaggctcttgagaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9216 - DNA, 2070 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9217 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9218 - DNA, 2727 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9219 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9220 - DNA, 2652 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9221 - DNA, 2601 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9222 - DNA, 2577 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaggcggaggcggaagtggaggcggaggatctggcggcggaggctcttgagaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9223 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaggcggaggcggaagtggaggcggaggatctggcggcggaggctcttgagaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9224 - DNA, 2655 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaggcggaggcggaagtggaggcggaggatctggcggcggaggctcttgagaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9225 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaggcggaggcggaagtggaggcggaggatctggcggcggaggctcttgagaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9226 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9227 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9228 - DNA, 1941 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9229 - DNA, 1938 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9230 - DNA, 1926 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9231 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9232 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9233 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9234 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9235 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9236 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9237 - DNA, 2709 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9238 - DNA, 3741 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9239 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9240 - DNA, 4236 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9241 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9242 - DNA, 2046 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9243 - DNA, 1986 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9244 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9245 - DNA, 2142 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9246 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9247 - DNA, 2007 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9248 - DNA, 1542 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9249 - DNA, 1545 bp, Artificial Sequence
  Synthetic Polynucleotide encoding a CAR with optional accessory module(s)
atggccttaccagtgaccgccttgctcctgccgctggccttgctgctccacgccgccaggccgcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaggcggaggcggaagtggaggcggaggatctggcggcggaggctcttgagaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9250 - DNA, 2070 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9251 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9252 - DNA, 2727 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9253 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9254 - DNA, 2652 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9255 - DNA, 2601 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9256 - DNA, 2577 bp, Artificial Sequence
  Synthetic Polynucleotide encoding a CAR with optional accessory module(s)
atggccttaccagtgaccgccttgctcctgccgctggccttgctgctccacgccgccaggccgcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaggcggaggcggaagtggaggcggaggatctggcggcggaggctcttgagaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9257 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccgcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaggcggaggcggaagtggaggcggaggatctggcggcggaggctcttgagaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9258 - DNA, 2655 bp, Artificial Sequence
  Synthetic Polynucleotide encoding a CAR with optional accessory module(s)
atggccttaccagtgaccgccttgctcctgccgctggccttgctgctccacgccgccaggccgcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaggcggaggcggaagtggaggcggaggatctggcggcggaggctcttgagaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9259 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccgcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaggcggaggcggaagtggaggcggaggatctggcggcggaggctcttgagaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9260 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9261 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9262 - DNA, 1941 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9263 - DNA, 1938 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9264 - DNA, 1926 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9265 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9266 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9267 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9268 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9269 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9270 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9271 - DNA, 2709 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9272 - DNA, 3741 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9273 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9274 - DNA, 4236 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9275 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9276 - DNA, 2046 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9277 - DNA, 1986 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9278 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9279 - DNA, 2142 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9280 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9281 - DNA, 2007 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9282 - DNA, 1545 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9283 - DNA, 1548 bp, Artificial Sequence
  Synthetic Polynucleotide encoding a CAR with optional accessory module(s)
atggccttaccagtgaccgccttgctcctgccgctggccttgctgctccacgccgccaggccgcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaggcggaggcggaagtggaggcggaggatctggcggcggaggctcttgagaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9284 - DNA, 2073 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9285 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9286 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9287 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9288 - DNA, 2655 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9289 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9290 - DNA, 2580 bp, Artificial Sequence
  Synthetic Polynucleotide encoding a CAR with optional accessory module(s)
atggccttaccagtgaccgccttgctcctgccgctggccttgctgctccacgccgccaggccgcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaggcggaggcggaagtggaggcggaggatctggcggcggaggctcttgagaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9291 - DNA, 2628 bp, Artificial Sequence
  Synthetic Polynucleotide encoding a CAR with optional accessory module(s)
atggccttaccagtgaccgccttgctcctgccgctggccttgctgctccacgccgccaggccgcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaggcggaggcggaagtggaggcggaggatctggcggcggaggctcttgagaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9292 - DNA, 2658 bp, Artificial Sequence
  Synthetic Polynucleotide encoding a CAR with optional accessory module(s)
atggccttaccagtgaccgccttgctcctgccgctggccttgctgctccacgccgccaggccgcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaggcggaggcggaagtggaggcggaggatctggcggcggaggctcttgagaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9293 - DNA, 2607 bp, Artificial Sequence
  Synthetic Polynucleotide encoding a CAR with optional accessory module(s)
atggccttaccagtgaccgccttgctcctgccgctggccttgctgctccacgccgccaggccgcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaggcggaggcggaagtggaggcggaggatctggcggcggaggctcttgagaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9294 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9295 - DNA, 1914 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9296 - DNA, 1944 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9297 - DNA, 1941 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9298 - DNA, 1929 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9299 - DNA, 1992 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9300 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9301 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9302 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9303 - DNA, 3273 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9304 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9305 - DNA, 2712 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9306 - DNA, 3744 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9307 - DNA, 3264 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9308 - DNA, 4239 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9309 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9310 - DNA, 2049 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9311 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9312 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9313 - DNA, 2145 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9314 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9315 - DNA, 2010 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9316 - DNA, 1542 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9317 - DNA, 1545 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaggcggaggcggaagtggaggcggaggatctggcggcggaggctcttgagaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9318 - DNA, 2070 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9319 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9320 - DNA, 2727 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9321 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9322 - DNA, 2652 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9323 - DNA, 2601 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9324 - DNA, 2577 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaggcggaggcggaagtggaggcggaggatctggcggcggaggctcttgagaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9325 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaggcggaggcggaagtggaggcggaggatctggcggcggaggctcttgagaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9326 - DNA, 2655 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaggcggaggcggaagtggaggcggaggatctggcggcggaggctcttgagaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9327 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaggcggaggcggaagtggaggcggaggatctggcggcggaggctcttgagaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9328 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9329 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9330 - DNA, 1941 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9331 - DNA, 1938 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9332 - DNA, 1926 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9333 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9334 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9335 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9336 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9337 - DNA, 3270 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9338 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9339 - DNA, 2709 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9340 - DNA, 3741 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9341 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9342 - DNA, 4236 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9343 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9344 - DNA, 2046 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9345 - DNA, 1986 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9346 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9347 - DNA, 2142 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9348 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9349 - DNA, 2007 bp, Artificial Sequence
  Synthetic Polynucleotide encoding a CAR with optional accessory module(s)
atggccttaccagtgaccgccttgctcctgccgctggccttgctgctccacgccgccaggccggaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctcaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9350 - DNA, 1509 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9351 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9352 - DNA, 2037 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9353 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9354 - DNA, 2694 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9355 - DNA, 2589 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9356 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9357 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9358 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9359 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9360 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9361 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9362 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9363 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9364 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9365 - DNA, 1905 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9366 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9367 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9368 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9369 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9370 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9371 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9372 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9373 - DNA, 2676 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9374 - DNA, 3708 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9375 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9376 - DNA, 4203 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9377 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9378 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9379 - DNA, 1953 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9380 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9381 - DNA, 2109 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9382 - DNA, 2157 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9383 - DNA, 1974 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9384 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9385 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccgcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtggcggaggcggaagtggaggcggaggatctggcggcggaggctcttgagacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9386 - DNA, 2040 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9387 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9388 - DNA, 2697 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9389 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9390 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9391 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9392 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccgcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtggcggaggcggaagtggaggcggaggatctggcggcggaggctcttgagacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9393 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccgcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtggcggaggcggaagtggaggcggaggatctggcggcggaggctcttgagacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9394 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccgcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtggcggaggcggaagtggaggcggaggatctggcggcggaggctcttgagacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9395 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccgcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtggcggaggcggaagtggaggcggaggatctggcggcggaggctcttgagacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9396 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9397 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9398 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9399 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9400 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9401 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9402 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9403 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9404 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9405 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9406 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9407 - DNA, 2679 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9408 - DNA, 3711 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9409 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9410 - DNA, 4206 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9411 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9412 - DNA, 2016 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9413 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9414 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9415 - DNA, 2112 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9416 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9417 - DNA, 1977 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9418 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9419 - DNA, 1518 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9420 - DNA, 2043 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9421 - DNA, 2736 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9422 - DNA, 2700 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9423 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9424 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9425 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9426 - DNA, 2550 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9427 - DNA, 2598 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9428 - DNA, 2628 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9429 - DNA, 2577 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9430 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9431 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9432 - DNA, 1914 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9433 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9434 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9435 - DNA, 1962 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9436 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9437 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9438 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9439 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9440 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9441 - DNA, 2682 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9442 - DNA, 3714 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9443 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9444 - DNA, 4209 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9445 - DNA, 3207 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9446 - DNA, 2019 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9447 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9448 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9449 - DNA, 2115 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9450 - DNA, 2163 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9451 - DNA, 1980 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9452 - DNA, 1525 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9453 - DNA, 1528 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9454 - DNA, 2053 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9455 - DNA, 2746 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9456 - DNA, 2710 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9457 - DNA, 2605 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9458 - DNA, 2635 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9459 - DNA, 2584 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9460 - DNA, 2560 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9461 - DNA, 2608 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9462 - DNA, 2638 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9463 - DNA, 2587 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9464 - DNA, 1879 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9465 - DNA, 1894 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9466 - DNA, 1924 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9467 - DNA, 1921 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9468 - DNA, 1909 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9469 - DNA, 1972 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9470 - DNA, 3241 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9471 - DNA, 3244 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9472 - DNA, 3403 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9473 - DNA, 3253 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9474 - DNA, 3241 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9475 - DNA, 2692 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9476 - DNA, 3724 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9477 - DNA, 3244 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9478 - DNA, 4219 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9479 - DNA, 3217 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9480 - DNA, 2029 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9481 - DNA, 1969 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9482 - DNA, 1879 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9483 - DNA, 2125 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9484 - DNA, 2173 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9485 - DNA, 1990 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccaccctgaccatcagcagcgtggaacccgaggacttcgccgtgtactactgcctccagagccggaccatccccagaacattcggccagggcaccaagctggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9486 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9487 - DNA, 1518 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9488 - DNA, 2043 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9489 - DNA, 2736 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9490 - DNA, 2700 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9491 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9492 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9493 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9494 - DNA, 2550 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9495 - DNA, 2598 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9496 - DNA, 2628 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9497 - DNA, 2577 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9498 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9499 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9500 - DNA, 1914 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9501 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9502 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9503 - DNA, 1962 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9504 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9505 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9506 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9507 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9508 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9509 - DNA, 2682 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9510 - DNA, 3714 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9511 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9512 - DNA, 4209 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9513 - DNA, 3207 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9514 - DNA, 2019 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9515 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9516 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9517 - DNA, 2115 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9518 - DNA, 2163 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9519 - DNA, 1980 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9520 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9521 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9522 - DNA, 2040 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9523 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9524 - DNA, 2697 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9525 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9526 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9527 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9528 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9529 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9530 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9531 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9532 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9533 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9534 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9535 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9536 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9537 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9538 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9539 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9540 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9541 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9542 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9543 - DNA, 2679 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9544 - DNA, 3711 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9545 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9546 - DNA, 4206 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9547 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9548 - DNA, 2016 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9549 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9550 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9551 - DNA, 2112 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9552 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9553 - DNA, 1977 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9554 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9555 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9556 - DNA, 2040 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9557 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9558 - DNA, 2697 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9559 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9560 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9561 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9562 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9563 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9564 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9565 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9566 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9567 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9568 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9569 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9570 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9571 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9572 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9573 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9574 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9575 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9576 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9577 - DNA, 2679 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9578 - DNA, 3711 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9579 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9580 - DNA, 4206 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9581 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9582 - DNA, 2016 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9583 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9584 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9585 - DNA, 2112 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9586 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9587 - DNA, 1977 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9588 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9589 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9590 - DNA, 2040 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9591 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9592 - DNA, 2697 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9593 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9594 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9595 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9596 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9597 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9598 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9599 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9600 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9601 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9602 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9603 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9604 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9605 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9606 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9607 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9608 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9609 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9610 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9611 - DNA, 2679 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9612 - DNA, 3711 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9613 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9614 - DNA, 4206 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9615 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9616 - DNA, 2016 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9617 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9618 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9619 - DNA, 2112 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9620 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9621 - DNA, 1977 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9622 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9623 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9624 - DNA, 2040 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9625 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9626 - DNA, 2697 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9627 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9628 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9629 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9630 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9631 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9632 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9633 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccggaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctggcggaggcggaagtggaggcggaggatctggcggcggaggctcttgagacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9634 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9635 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9636 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9637 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9638 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9639 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9640 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9641 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9642 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9643 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9644 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9645 - DNA, 2679 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9646 - DNA, 3711 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9647 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9648 - DNA, 4206 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9649 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9650 - DNA, 2016 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9651 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9652 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9653 - DNA, 2112 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9654 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9655 - DNA, 1977 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9656 - DNA, 1518 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9657 - DNA, 1521 bp, Artificial Sequence
  Synthetic Polynucleotide encoding a CAR with optional accessory module(s)
atggccttaccagtgaccgccttgctcctgccgctggccttgctgctccacgccgccaggccgcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcggcggaggcggaagtggaggcggaggatctggcggcggaggctcttgacagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9658 - DNA, 2046 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9659 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9660 - DNA, 2703 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9661 - DNA, 2598 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9662 - DNA, 2628 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9663 - DNA, 2577 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9664 - DNA, 2553 bp, Artificial Sequence
  Synthetic Polynucleotide encoding a CAR with optional accessory module(s)
atggccttaccagtgaccgccttgctcctgccgctggccttgctgctccacgccgccaggccgcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcggcggaggcggaagtggaggcggaggatctggcggcggaggctcttgacagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9665 - DNA, 2601 bp, Artificial Sequence
  Synthetic Polynucleotide encoding a CAR with optional accessory module(s)
atggccttaccagtgaccgccttgctcctgccgctggccttgctgctccacgccgccaggccgcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcggcggaggcggaagtggaggcggaggatctggcggcggaggctcttgacagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9666 - DNA, 2631 bp, Artificial Sequence
  Synthetic Polynucleotide encoding a CAR with optional accessory module(s)
atggccttaccagtgaccgccttgctcctgccgctggccttgctgctccacgccgccaggccgcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcggcggaggcggaagtggaggcggaggatctggcggcggaggctcttgacagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9667 - DNA, 2580 bp, Artificial Sequence
  Synthetic Polynucleotide encoding a CAR with optional accessory module(s)
atggccttaccagtgaccgccttgctcctgccgctggccttgctgctccacgccgccaggccgcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcggcggaggcggaagtggaggcggaggatctggcggcggaggctcttgacagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9668 - DNA, 1872 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9669 - DNA, 1887 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9670 - DNA, 1917 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9671 - DNA, 1914 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9672 - DNA, 1902 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9673 - DNA, 1965 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9674 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9675 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9676 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9677 - DNA, 3246 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9678 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9679 - DNA, 2685 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9680 - DNA, 3717 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9681 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9682 - DNA, 4212 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9683 - DNA, 3210 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9684 - DNA, 2022 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9685 - DNA, 1962 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9686 - DNA, 1872 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9687 - DNA, 2118 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9688 - DNA, 2166 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9689 - DNA, 1983 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9690-9723 - skipped (34 entries)

SEQ ID NO: 9724 - DNA, 1494 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagggcggaggcggaagtggaggcggaggatctggcggcggaggctctgaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9725 - DNA, 1497 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcggcggaggcggaagtggaggcggaggatctggcggcggaggctcttgagagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9726 - DNA, 2022 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagggcggaggcggaagtggaggcggaggatctggcggcggaggctctgaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9727 - DNA, 2715 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagggcggaggcggaagtggaggcggaggatctggcggcggaggctctgaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9728 - DNA, 2679 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagggcggaggcggaagtggaggcggaggatctggcggcggaggctctgaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9729 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagggcggaggcggaagtggaggcggaggatctggcggcggaggctctgaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9730 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagggcggaggcggaagtggaggcggaggatctggcggcggaggctctgaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9731 - DNA, 2553 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagggcggaggcggaagtggaggcggaggatctggcggcggaggctctgaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9732 - DNA, 2529 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcggcggaggcggaagtggaggcggaggatctggcggcggaggctcttgagagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9733 - DNA, 2577 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcggcggaggcggaagtggaggcggaggatctggcggcggaggctcttgagagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9734 - DNA, 2607 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcggcggaggcggaagtggaggcggaggatctggcggcggaggctcttgagagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9735 - DNA, 2556 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcggcggaggcggaagtggaggcggaggatctggcggcggaggctcttgagagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9736 - DNA, 1848 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9737 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9738 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9739 - DNA, 1890 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9740 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9741 - DNA, 1941 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9742 - DNA, 3210 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9743 - DNA, 3213 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9744 - DNA, 3372 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9745 - DNA, 3222 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9746 - DNA, 3210 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9747 - DNA, 2661 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagggcggaggcggaagtggaggcggaggatctggcggcggaggctctgaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9748 - DNA, 3693 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagggcggaggcggaagtggaggcggaggatctggcggcggaggctctgaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9749 - DNA, 3213 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9750 - DNA, 4188 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9751 - DNA, 3186 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9752 - DNA, 1998 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagggcggaggcggaagtggaggcggaggatctggcggcggaggctctgaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9753 - DNA, 1938 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9754 - DNA, 1848 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9755 - DNA, 2094 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9756 - DNA, 2142 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagggcggaggcggaagtggaggcggaggatctggcggcggaggctctgaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9757 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaagctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9758 - DNA, 1512 bp, Artificial Sequence; identical to SEQ ID NO: 1590
  Synthetic Polynucleotide encoding a CAR with optional accessory module(s)

SEQ ID NO: 9759 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtggcggaggcggaagtggaggcggaggatctggcggcggaggctcttgagacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9760 - DNA, 2040 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9761 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9762 - DNA, 2697 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9763 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9764 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9765 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9766 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtggcggaggcggaagtggaggcggaggatctggcggcggaggctcttgagacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9767 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtggcggaggcggaagtggaggcggaggatctggcggcggaggctcttgagacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9768 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtggcggaggcggaagtggaggcggaggatctggcggcggaggctcttgagacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9769 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtggcggaggcggaagtggaggcggaggatctggcggcggaggctcttgagacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9770 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9771 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9772 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9773 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9774 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9775 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9776 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9777 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9778 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9779 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9780 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9781 - DNA, 2679 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9782 - DNA, 3711 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9783 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9784 - DNA, 4206 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9785 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9786 - DNA, 2016 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9787 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9788 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9789 - DNA, 2112 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9790 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9791 - DNA, 1977 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9792 - DNA, 1509 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9793 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9794 - DNA, 2037 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9795 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9796 - DNA, 2694 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9797 - DNA, 2589 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9798 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9799 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9800 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9801 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9802 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9803 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9804 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9805 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9806 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9807 - DNA, 1905 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9808 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9809 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9810 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9811 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9812 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9813 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9814 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9815 - DNA, 2676 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9816 - DNA, 3708 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9817 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9818 - DNA, 4203 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9819 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9820 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9821 - DNA, 1953 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9822 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9823 - DNA, 2109 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9824 - DNA, 2157 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9825 - DNA, 1974 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9826 - DNA, 1503 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaggcggaggcggaagtggaggcggaggatctggcggcggaggctctcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9827 - DNA, 1506 bp, Artificial Sequence
  Synthetic Polynucleotide encoding a CAR with optional accessory module(s)
atggccttaccagtgaccgccttgctcctgccgctggccttgctgctccacgccgccaggccgcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctggcggaggcggaagtggaggcggaggatctggcggcggaggctcttgagccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9828 - DNA, 2031 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaggcggaggcggaagtggaggcggaggatctggcggcggaggctctcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9829 - DNA, 2724 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaggcggaggcggaagtggaggcggaggatctggcggcggaggctctcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9830 - DNA, 2688 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaggcggaggcggaagtggaggcggaggatctggcggcggaggctctcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9831 - DNA, 2583 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaggcggaggcggaagtggaggcggaggatctggcggcggaggctctcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9832 - DNA, 2613 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaggcggaggcggaagtggaggcggaggatctggcggcggaggctctcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9833 - DNA, 2562 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaggcggaggcggaagtggaggcggaggatctggcggcggaggctctcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9834 - DNA, 2538 bp, Artificial Sequence
  Synthetic Polynucleotide encoding a CAR with optional accessory module(s)
atggccttaccagtgaccgccttgctcctgccgctggccttgctgctccacgccgccaggccgcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctggcggaggcggaagtggaggcggaggatctggcggcggaggctcttgagccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9835 - DNA, 2586 bp, Artificial Sequence
  Synthetic Polynucleotide encoding a CAR with optional accessory module(s)
atggccttaccagtgaccgccttgctcctgccgctggccttgctgctccacgccgccaggccgcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctggcggaggcggaagtggaggcggaggatctggcggcggaggctcttgagccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9836 - DNA, 2616 bp, Artificial Sequence
  Synthetic Polynucleotide encoding a CAR with optional accessory module(s)
atggccttaccagtgaccgccttgctcctgccgctggccttgctgctccacgccgccaggccgcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctggcggaggcggaagtggaggcggaggatctggcggcggaggctcttgagccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9837 - DNA, 2565 bp, Artificial Sequence
  Synthetic Polynucleotide encoding a CAR with optional accessory module(s)
atggccttaccagtgaccgccttgctcctgccgctggccttgctgctccacgccgccaggccgcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctggcggaggcggaagtggaggcggaggatctggcggcggaggctcttgagccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9838 - DNA, 1857 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9839 - DNA, 1872 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9840 - DNA, 1902 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9841 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9842 - DNA, 1887 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9843 - DNA, 1950 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9844 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9845 - DNA, 3222 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9846 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9847 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9848 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9849 - DNA, 2670 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaggcggaggcggaagtggaggcggaggatctggcggcggaggctctcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9850 - DNA, 3702 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaggcggaggcggaagtggaggcggaggatctggcggcggaggctctcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9851 - DNA, 3222 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9852 - DNA, 4197 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9853 - DNA, 3195 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9854 - DNA, 2007 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaggcggaggcggaagtggaggcggaggatctggcggcggaggctctcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9855 - DNA, 1947 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9856 - DNA, 1857 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9857 - DNA, 2103 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9858 - DNA, 2151 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaaggcggaggcggaagtggaggcggaggatctggcggcggaggctctcaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9859 - DNA, 1968 bp, Artificial Sequence
  Synthetic Polynucleotide encoding a CAR with optional accessory module(s)
atggccttaccagtgaccgccttgctcctgccgctggccttgctgctccacgccgccaggccggccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9860 - DNA, 1509 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9861 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctggcggaggcggaagtggaggcggaggatctggcggcggaggctcttgagagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9862 - DNA, 2037 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9863 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9864 - DNA, 2694 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9865 - DNA, 2589 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9866 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9867 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9868 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctggcggaggcggaagtggaggcggaggatctggcggcggaggctcttgagagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9869 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctggcggaggcggaagtggaggcggaggatctggcggcggaggctcttgagagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9870 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctggcggaggcggaagtggaggcggaggatctggcggcggaggctcttgagagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9871 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctggcggaggcggaagtggaggcggaggatctggcggcggaggctcttgagagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9872 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9873 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9874 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9875 - DNA, 1905 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9876 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9877 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9878 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9879 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9880 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9881 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9882 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9883 - DNA, 2676 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9884 - DNA, 3708 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9885 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9886 - DNA, 4203 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9887 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9888 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9889 - DNA, 1953 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9890 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9891 - DNA, 2109 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9892 - DNA, 2157 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9893 - DNA, 1974 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9894 - DNA, 1509 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9895 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctcttgagaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9896 - DNA, 2037 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9897 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9898 - DNA, 2694 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9899 - DNA, 2589 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9900 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9901 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9902 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccggaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctcttgagaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9903 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctcttgagaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9904 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctcttgagaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9905 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctcttgagaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9906 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9907 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9908 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9909 - DNA, 1905 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9910 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9911 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9912 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9913 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9914 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9915 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9916 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9917 - DNA, 2676 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9918 - DNA, 3708 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9919 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9920 - DNA, 4203 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9921 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9922 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9923 - DNA, 1953 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9924 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9925 - DNA, 2109 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9926 - DNA, 2157 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9927 - DNA, 1974 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaagctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9928 - DNA, 1509 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9929 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctcttgagaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9930 - DNA, 2037 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9931 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9932 - DNA, 2694 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9933 - DNA, 2589 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9934 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9935 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9936 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccggaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctcttgagaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9937 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctcttgagaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9938 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctcttgagaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9939 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctcttgagaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9940 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9941 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9942 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9943 - DNA, 1905 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9944 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9945 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9946 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9947 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9948 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9949 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9950 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9951 - DNA, 2676 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9952 - DNA, 3708 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9953 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9954 - DNA, 4203 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9955 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9956 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9957 - DNA, 1953 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9958 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9959 - DNA, 2109 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9960 - DNA, 2157 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagggcggaggcggaagtggaggcggaggatctggcggcggaggctctgaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9961 - DNA, 1974 bp, Artificial Sequence
  Synthetic Polynucleotide encoding a CAR with optional accessory module(s)
atggccttaccagtgaccgccttgctcctgccgctggccttgctgctccacgccgccaggccggaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaagctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9962 - DNA, 1509 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9963 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9964 - DNA, 2037 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9965 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9966 - DNA, 2694 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9967 - DNA, 2589 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9968 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9969 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9970 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 9971 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9972 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9973 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9974 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9975 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9976 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9977 - DNA, 1905 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9978 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9979 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9980 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9981 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9982 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 9983 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9984 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9985 - DNA, 2676 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9986 - DNA, 3708 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 9987 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 9988 - DNA, 4203 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 9989 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 9990 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 9991 - DNA, 1953 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9992 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 9993 - DNA, 2109 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9994 - DNA, 2157 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 9995 - DNA, 1974 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 9996 - DNA, 1509 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9997 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 9998 - DNA, 2037 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 9999 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10000 - DNA, 2694 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10001 - DNA, 2589 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10002 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10003 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10004 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10005 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10006 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10007 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctggcggaggcggaagtggaggcggaggatctggcggcggaggctcttgagagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10008 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10009 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10010 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10011 - DNA, 1905 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10012 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10013 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10014 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10015 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10016 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10017 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10018 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10019 - DNA, 2676 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10020 - DNA, 3708 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10021 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10022 - DNA, 4203 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10023 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10024 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10025 - DNA, 1953 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10026 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10027 - DNA, 2109 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10028 - DNA, 2157 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10029 - DNA, 1974 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10030 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagggcggaggcggaagtggaggcggaggatctggcggcggaggctctcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10031 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcggcggaggcggaagtggaggcggaggatctggcggcggaggctcttgagaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10032 - DNA, 2040 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagggcggaggcggaagtggaggcggaggatctggcggcggaggctctcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10033 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagggcggaggcggaagtggaggcggaggatctggcggcggaggctctcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10034 - DNA, 2697 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagggcggaggcggaagtggaggcggaggatctggcggcggaggctctcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10035 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagggcggaggcggaagtggaggcggaggatctggcggcggaggctctcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10036 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagggcggaggcggaagtggaggcggaggatctggcggcggaggctctcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10037 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagggcggaggcggaagtggaggcggaggatctggcggcggaggctctcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10038 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcggcggaggcggaagtggaggcggaggatctggcggcggaggctcttgagaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10039 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcggcggaggcggaagtggaggcggaggatctggcggcggaggctcttgagaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10040 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcggcggaggcggaagtggaggcggaggatctggcggcggaggctcttgagaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10041 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcggcggaggcggaagtggaggcggaggatctggcggcggaggctcttgagaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10042 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10043 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10044 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10045 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10046 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10047 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10048 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10049 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10050 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10051 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10052 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10053 - DNA, 2679 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagggcggaggcggaagtggaggcggaggatctggcggcggaggctctcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10054 - DNA, 3711 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagggcggaggcggaagtggaggcggaggatctggcggcggaggctctcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10055 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10056 - DNA, 4206 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10057 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10058 - DNA, 2016 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagggcggaggcggaagtggaggcggaggatctggcggcggaggctctcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10059 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10060 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10061 - DNA, 2112 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10062 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagggcggaggcggaagtggaggcggaggatctggcggcggaggctctcaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10063 - DNA, 1977 bp, Artificial Sequence
  Synthetic Polynucleotide encoding a CAR with optional accessory module(s)
atggccttaccagtgaccgccttgctcctgccgctggccttgctgctccacgccgccaggccggaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaagctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10064 - DNA, 1509 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10065 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtggcggaggcggaagtggaggcggaggatctggcggcggaggctcttgagagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10066 - DNA, 2037 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10067 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga
